United States Patent 10,407,724 (METHODS AND COMPOSITIONS FOR SCREENING AND TREATING DEVELOPMENTAL DISORDERS) - sequence listing, part 69

SEQ ID NO: 1862 - DNA, 1900974 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcat
